United States Patent 11,965,166 (COMPLEMENT FACTOR B (CFB) iRNA COMPOSITIONS AND METHODS OF USE THEREOF) - sequence listing, part 2

SEQ ID NO: 2259 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agaaagagatctcatcactcaca

SEQ ID NO: 2260 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aagtggaaagagatctcatcact

SEQ ID NO: 2261 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agtcatagcagtggaaagagatc

SEQ ID NO: 2262 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acgtcatagcagtggaaagagat

SEQ ID NO: 2263 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aagtgtaaccgtcatagcagtgg

SEQ ID NO: 2264 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agagtgtaaccgtcatagcagtg

SEQ ID NO: 2265 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
acattcacttggcaggtgcgatt

SEQ ID NO: 2266 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
attgtcacagatcgctgtctgcc

SEQ ID NO: 2267 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acgttgtcacagatcgctgtctg

SEQ ID NO: 2268 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atgcccaccttccttgtgccaat

SEQ ID NO: 2269 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agtaggtgacgctgtcttcaagg

SEQ ID NO: 2270 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgtcgtacatgaaggagtcttg

SEQ ID NO: 2271 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aaaagcttcggccacctcttgag

SEQ ID NO: 2272 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atcgactccttctatggtctctg

SEQ ID NO: 2273 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agtagatgttcatggagcctgaa

SEQ ID NO: 2274 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
accatctagcaccaggtagatgt

SEQ ID NO: 2275 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aatccatctagcaccaggtagat

SEQ ID NO: 2276 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agatccatctagcaccaggtaga

SEQ ID NO: 2277 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agtctgatccatctagcaccagg

SEQ ID NO: 2278 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
actgtctgatccatctagcacca

SEQ ID NO: 2279 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agacactttttggctcctgtgaa

SEQ ID NO: 2280 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atagacactttttggctcctgtg

SEQ ID NO: 2281 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aactagacactttttggctcctg

SEQ ID NO: 2282 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atgactagacactttttggctcc

SEQ ID NO: 2283 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
attgactagacactttttggctc

SEQ ID NO: 2284 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aagttgactagacactttttggc

SEQ ID NO: 2285 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
ataagttgactagacactttttg

SEQ ID NO: 2286 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
attaagttgactagacacttttt

SEQ ID NO: 2287 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
accttctcaattaagttgactag

SEQ ID NO: 2288 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aatatcttggcttcacaccataa

SEQ ID NO: 2289 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agacactttgacccaaattttgg

SEQ ID NO: 2290 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atcgtgacccagtctgcattact

SEQ ID NO: 2291 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atcttcataattgatttcattga

SEQ ID NO: 2292 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggtcttcataattgatttcatt

SEQ ID NO: 2293 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgtggtcttcataattgatttc

SEQ ID NO: 2294 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aacttgtggtcttcataattgat

SEQ ID NO: 2295 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atcaacttgtggtcttcataatt

SEQ ID NO: 2296 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgacttcaacttgtggtcttca

SEQ ID NO: 2297 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
accctgacttcaacttgtggtct

SEQ ID NO: 2298 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agtccctgacttcaacttgtggt

SEQ ID NO: 2299 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agtgttagtccctgacttcaact

SEQ ID NO: 2300 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggtgttagtccctgacttcaac

SEQ ID NO: 2301 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acttggtgttagtccctgacttc

SEQ ID NO: 2302 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
accatgttgtgcaatccatcagt

SEQ ID NO: 2303 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agtttttgcgatccttgccaatg

SEQ ID NO: 2304 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggtttttgcgatccttgccaat

SEQ ID NO: 2305 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agggtttttgcgatccttgccaa

SEQ ID NO: 2306 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atagacatccagataatcctccc

SEQ ID NO: 2307 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aaagcattgatgttcacttggtt

SEQ ID NO: 2308 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaaagcattgatgttcacttggt

SEQ ID NO: 2309 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
attggaagccaaagcattgatgt

SEQ ID NO: 2310 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
acttggaagccaaagcattgatg

SEQ ID NO: 2311 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agctcattgtctttcttggaagc

SEQ ID NO: 2312 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atgctcattgtctttcttggaag

SEQ ID NO: 2313 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agttgctcattgtctttcttgga

SEQ ID NO: 2314 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aacatgttgctcattgtctttct

SEQ ID NO: 2315 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaacacatgttgctcattgtctt

SEQ ID NO: 2316 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atgaacacatgttgctcattgtc

SEQ ID NO: 2317 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atttgaacacatgttgctcattg

SEQ ID NO: 2318 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agactttgaacacatgttgctca

SEQ ID NO: 2319 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
attgactttgaacacatgttgct

SEQ ID NO: 2320 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
accttgactttgaacacatgttg

SEQ ID NO: 2321 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aatccttgactttgaacacatgt

SEQ ID NO: 2322 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atatccttgactttgaacacatg

SEQ ID NO: 2323 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
attccatatccttgactttgaac

SEQ ID NO: 2324 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atttccatatccttgactttgaa

SEQ ID NO: 2325 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agactcagagactggctttcatc

SEQ ID NO: 2326 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgtgttcccaaaccatgccaca

SEQ ID NO: 2327 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcttgtggtaatcggtaccctt

SEQ ID NO: 2328 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agttgcttgtggtaatcggtacc

SEQ ID NO: 2329 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aatggttgcttgtggtaatcggt

SEQ ID NO: 2330 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgccatggttgcttgtggtaat

SEQ ID NO: 2331 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagatcttggcctgccatggttg

SEQ ID NO: 2332 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgagatcttggcctgccatggt

SEQ ID NO: 2333 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aaaagtactcagacaccacagcc

SEQ ID NO: 2334 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
attctatctccaggtcccgcttc

SEQ ID NO: 2335 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaattcaggaattcctgcttctt

SEQ ID NO: 2336 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagtcataaaattcaggaattcc

SEQ ID NO: 2337 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atagtcataaaattcaggaattc

SEQ ID NO: 2338 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acatagtcataaaattcaggaat

SEQ ID NO: 2339 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agtcatagtcataaaattcagga

SEQ ID NO: 2340 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aacgtcatagtcataaaattcag

SEQ ID NO: 2341 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agggcaacgtcatagtcataaaa

SEQ ID NO: 2342 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aagggcaacgtcatagtcataaa

SEQ ID NO: 2343 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acttgatcagggcaacgtcatag

SEQ ID NO: 2344 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agcttgatcagggcaacgtcata

SEQ ID NO: 2345 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agagcttgatcagggcaacgtca

SEQ ID NO: 2346 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aaaagctcgagttgttccctcgg

SEQ ID NO: 2347 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aaagcctcaaagctcgagttgtt

SEQ ID NO: 2348 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agttggaggaagcctcaaagctc

SEQ ID NO: 2349 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agtggtagttggaggaagcctca

SEQ ID NO: 2350 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcaagtggtagttggaggaagc

SEQ ID NO: 2351 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
attgatatcctgtgcagggagca

SEQ ID NO: 2352 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atttgatatcctgtgcagggagc

SEQ ID NO: 2353 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
actttgatatcctgtgcagggag

SEQ ID NO: 2354 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagctttgatatcctgtgcaggg

SEQ ID NO: 2355 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aaacagagctttgatatcctgtg

SEQ ID NO: 2356 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagacctccttccgagtcagctt

SEQ ID NO: 2357 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgatgtagacctccttccgagt

SEQ ID NO: 2358 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aattcttgatgtagacctccttc

SEQ ID NO: 2359 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
actctcacagctgcctttcttat

SEQ ID NO: 2360 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atgagcatctctctcacagctgc

SEQ ID NO: 2361 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atattgagcatctctctcacagc

SEQ ID NO: 2362 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
accttgactttgtcatagcctgg

SEQ ID NO: 2363 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aactcctccagtacaaaggaacc

SEQ ID NO: 2364 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agactcactcctccagtacaaag

SEQ ID NO: 2365 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agggactcactcctccagtacaa

SEQ ID NO: 2366 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atagggactcactcctccagtac

SEQ ID NO: 2367 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atcagcatagggactcactcctc

SEQ ID NO: 2368 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agaatcacctctgcaagtattgg

SEQ ID NO: 2369 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aacttctcttgtgaactatcaag

SEQ ID NO: 2370 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agaatgaaacgacttctcttgtg

SEQ ID NO: 2371 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atttgcagacatccactactccc

SEQ ID NO: 2372 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agtttttgcagacatccactact

SEQ ID NO: 2373 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggtttttgcagacatccactac

SEQ ID NO: 2374 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atggtttttgcagacatccacta

SEQ ID NO: 2375 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atctggtttttgcagacatccac

SEQ ID NO: 2376 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcttttgccgcttctggttttt

SEQ ID NO: 2377 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgcttttgccgcttctggtttt

SEQ ID NO: 2378 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atggagtttctccttcagccagg

SEQ ID NO: 2379 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agctgttttaattcaatcccacg

SEQ ID NO: 2380 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagctgttttaattcaatcccac

SEQ ID NO: 2381 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agtcgcagctgttttaattcaat

SEQ ID NO: 2382 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
attgtcgcagctgttttaattca

SEQ ID NO: 2383 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgtcgcagctgttttaattca

SEQ ID NO: 2384 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agttgtcgcagctgttttaattc

SEQ ID NO: 2385 - RNA, 23 nt, synthetic construct
  source 1..23: mol_type = other RNA
ggaagggaatgtgaccaggtcta

SEQ ID NO: 2386 - RNA, 23 nt, synthetic construct
  source 1..23: mol_type = other RNA
gaagggaatgtgaccaggtctag

SEQ ID NO: 2387 - RNA, 23 nt, synthetic construct
  source 1..23: mol_type = other RNA
aagggaatgtgaccaggtctagg

SEQ ID NO: 2388 - RNA, 23 nt, synthetic construct
  source 1..23: mol_type = other RNA
agggaatgtgaccaggtctaggt

SEQ ID NO: 2389 - RNA, 23 nt, synthetic construct
  source 1..23: mol_type = other RNA
aatgtgaccaggtctaggtctgg

SEQ ID NO: 2390 - RNA, 23 nt, synthetic construct
  source 1..23: mol_type = other RNA
atgtgaccaggtctaggtctgga

SEQ ID NO: 2391 - RNA, 23 nt, synthetic construct
  source 1..23: mol_type = other RNA
ccaggtctaggtctggagtttca

SEQ ID NO: 2392 - RNA, 23 nt, synthetic construct
  source 1..23: mol_type = other RNA
aggtctggagtttcagcttggac

SEQ ID NO: 2393 - RNA, 23 nt, synthetic construct
  source 1..23: mol_type = other RNA
ggtctggagtttcagcttggaca

SEQ ID NO: 2394 - RNA, 23 nt, synthetic construct
  source 1..23: mol_type = other RNA
gtctggagtttcagcttggacac

SEQ ID NO: 2395 - RNA, 23 nt, synthetic construct
  source 1..23: mol_type = other RNA
gctccttccgacttctccaagag

SEQ ID NO: 2396 - RNA, 23 nt, synthetic construct
  source 1..23: mol_type = other RNA
tgtgtccttctggcttctacccg

SEQ ID NO: 2397 - RNA, 23 nt, synthetic construct
  source 1..23: mol_type = other RNA
tgtccttctggcttctacccgta

SEQ ID NO: 2398 - RNA, 23 nt, synthetic construct
  source 1..23: mol_type = other RNA
gtccttctggcttctacccgtac

SEQ ID NO: 2399 - RNA, 23 nt, synthetic construct
  source 1..23: mol_type = other RNA
tccttctggcttctacccgtacc

SEQ ID NO: 2400 - RNA, 23 nt, synthetic construct
  source 1..23: mol_type = other RNA
ttctggcttctacccgtaccctg

SEQ ID NO: 2401 - RNA, 23 nt, synthetic construct
  source 1..23: mol_type = other RNA
ttctacccgtaccctgtgcagac

SEQ ID NO: 2402 - RNA, 23 nt, synthetic construct
  source 1..23: mol_type = other RNA
tgtgcagacacgtacctgcagat

SEQ ID NO: 2403 - RNA, 23 nt, synthetic construct
  source 1..23: mol_type = other RNA
ggaaggcagagtgcagagcaatc

SEQ ID NO: 2404 - RNA, 23 nt, synthetic construct
  source 1..23: mol_type = other RNA
aaggcagagtgcagagcaatcca

SEQ ID NO: 2405 - RNA, 23 nt, synthetic construct
  source 1..23: mol_type = other RNA
cccggtctccctactacaatgtg

SEQ ID NO: 2406 - RNA, 23 nt, synthetic construct
  source 1..23: mol_type = other RNA
ctccctactacaatgtgagtgat

SEQ ID NO: 2407 - RNA, 23 nt, synthetic construct
  source 1..23: mol_type = other RNA
tccctactacaatgtgagtgatg

SEQ ID NO: 2408 - RNA, 23 nt, synthetic construct
  source 1..23: mol_type = other RNA
ccctactacaatgtgagtgatga

SEQ ID NO: 2409 - RNA, 23 nt, synthetic construct
  source 1..23: mol_type = other RNA
ctactacaatgtgagtgatgaga

SEQ ID NO: 2410 - RNA, 23 nt, synthetic construct
  source 1..23: mol_type = other RNA
ctacaatgtgagtgatgagatct

SEQ ID NO: 2411 - RNA, 23 nt, synthetic construct
  source 1..23: mol_type = other RNA
tacaatgtgagtgatgagatctc

SEQ ID NO: 2412 - RNA, 23 nt, synthetic construct
  source 1..23: mol_type = other RNA
acaatgtgagtgatgagatctct

SEQ ID NO: 2413 - RNA, 23 nt, synthetic construct
  source 1..23: mol_type = other RNA
caatgtgagtgatgagatctctt

SEQ ID NO: 2414 - RNA, 23 nt, synthetic construct
  source 1..23: mol_type = other RNA
aatgtgagtgatgagatctcttt

SEQ ID NO: 2415 - RNA, 23 nt, synthetic construct
  source 1..23: mol_type = other RNA
atgtgagtgatgagatctctttc

SEQ ID NO: 2416 - RNA, 23 nt, synthetic construct
  source 1..23: mol_type = other RNA
tgtgagtgatgagatctctttcc

SEQ ID NO: 2417 - RNA, 23 nt, synthetic construct
  source 1..23: mol_type = other RNA
gtgagtgatgagatctctttcca

SEQ ID NO: 2418 - RNA, 23 nt, synthetic construct
  source 1..23: mol_type = other RNA
tgagtgatgagatctctttccac

SEQ ID NO: 2419 - RNA, 23 nt, synthetic construct
  source 1..23: mol_type = other RNA
gagtgatgagatctctttccact

SEQ ID NO: 2420 - RNA, 23 nt, synthetic construct
  source 1..23: mol_type = other RNA
agtgatgagatctctttccactg

SEQ ID NO: 2421 - RNA, 23 nt, synthetic construct
  source 1..23: mol_type = other RNA
gagatctctttccactgctatga

SEQ ID NO: 2422 - RNA, 23 nt, synthetic construct
  source 1..23: mol_type = other RNA
agatctctttccactgctatgac

SEQ ID NO: 2423 - RNA, 23 nt, synthetic construct
  source 1..23: mol_type = other RNA
gatctctttccactgctatgacg

SEQ ID NO: 2424 - RNA, 23 nt, synthetic construct
  source 1..23: mol_type = other RNA
atctctttccactgctatgacgg

SEQ ID NO: 2425 - RNA, 23 nt, synthetic construct
  source 1..23: mol_type = other RNA
tctctttccactgctatgacggt

SEQ ID NO: 2426 - RNA, 23 nt, synthetic construct
  source 1..23: mol_type = other RNA
ccactgctatgacggttacactc

SEQ ID NO: 2427 - RNA, 23 nt, synthetic construct
  source 1..23: mol_type = other RNA
cactgctatgacggttacactct

SEQ ID NO: 2428 - RNA, 23 nt, synthetic construct
  source 1..23: mol_type = other RNA
gctatgacggttacactctccgg

SEQ ID NO: 2429 - RNA, 23 nt, synthetic construct
  source 1..23: mol_type = other RNA
ctatgacggttacactctccggg

SEQ ID NO: 2430 - RNA, 23 nt, synthetic construct
  source 1..23: mol_type = other RNA
caatcgcacctgccaagtgaatg

SEQ ID NO: 2431 - RNA, 23 nt, synthetic construct
  source 1..23: mol_type = other RNA
aatcgcacctgccaagtgaatgg

SEQ ID NO: 2432 - RNA, 23 nt, synthetic construct
  source 1..23: mol_type = other RNA
atcgcacctgccaagtgaatggc

SEQ ID NO: 2433 - RNA, 23 nt, synthetic construct
  source 1..23: mol_type = other RNA
ggcagacagcgatctgtgacaac

SEQ ID NO: 2434 - RNA, 23 nt, synthetic construct
  source 1..23: mol_type = other RNA
gcagacagcgatctgtgacaacg

SEQ ID NO: 2435 - RNA, 23 nt, synthetic construct
  source 1..23: mol_type = other RNA
cagacagcgatctgtgacaacgg

SEQ ID NO: 2436 - RNA, 23 nt, synthetic construct
  source 1..23: mol_type = other RNA
agacagcgatctgtgacaacgga

SEQ ID NO: 2437 - RNA, 23 nt, synthetic construct
  source 1..23: mol_type = other RNA
gacagcgatctgtgacaacggag

SEQ ID NO: 2438 - RNA, 23 nt, synthetic construct
  source 1..23: mol_type = other RNA
acagcgatctgtgacaacggagc

SEQ ID NO: 2439 - RNA, 23 nt, synthetic construct
  source 1..23: mol_type = other RNA
attggcacaaggaaggtgggcag

SEQ ID NO: 2440 - RNA, 23 nt, synthetic construct
  source 1..23: mol_type = other RNA
taccgccttgaagacagcgtcac

SEQ ID NO: 2441 - RNA, 23 nt, synthetic construct
  source 1..23: mol_type = other RNA
gccttgaagacagcgtcacctac

SEQ ID NO: 2442 - RNA, 23 nt, synthetic construct
  source 1..23: mol_type = other RNA
ccttgaagacagcgtcacctacc

SEQ ID NO: 2443 - RNA, 23 nt, synthetic construct
  source 1..23: mol_type = other RNA
cttgaagacagcgtcacctacca

SEQ ID NO: 2444 - RNA, 23 nt, synthetic construct
  source 1..23: mol_type = other RNA
acgtgtcaggaaggtggctcttg

SEQ ID NO: 2445 - RNA, 23 nt, synthetic construct
  source 1..23: mol_type = other RNA
agccttcctgccaagactccttc

SEQ ID NO: 2446 - RNA, 23 nt, synthetic construct
  source 1..23: mol_type = other RNA
cttcctgccaagactccttcatg

SEQ ID NO: 2447 - RNA, 23 nt, synthetic construct
  source 1..23: mol_type = other RNA
tcctgccaagactccttcatgta

SEQ ID NO: 2448 - RNA, 23 nt, synthetic construct
  source 1..23: mol_type = other RNA
cctgccaagactccttcatgtac

SEQ ID NO: 2449 - RNA, 23 nt, synthetic construct
  source 1..23: mol_type = other RNA
gccaagactccttcatgtacgac

SEQ ID NO: 2450 - RNA, 23 nt, synthetic construct
  source 1..23: mol_type = other RNA
ccaagactccttcatgtacgaca

SEQ ID NO: 2451 - RNA, 23 nt, synthetic construct
  source 1..23: mol_type = other RNA
caagactccttcatgtacgacac

SEQ ID NO: 2452 - RNA, 23 nt, synthetic construct
  source 1..23: mol_type = other RNA
aagactccttcatgtacgacacc

SEQ ID NO: 2453 - RNA, 23 nt, synthetic construct
  source 1..23: mol_type = other RNA
ctcaagaggtggccgaagctttc

SEQ ID NO: 2454 - RNA, 23 nt, synthetic construct
  source 1..23: mol_type = other RNA
tggccgaagctttcctgtcttcc

SEQ ID NO: 2455 - RNA, 23 nt, synthetic construct
  source 1..23: mol_type = other RNA
acagagaccatagaaggagtcga

SEQ ID NO: 2456 - RNA, 23 nt, synthetic construct
  source 1..23: mol_type = other RNA
cagagaccatagaaggagtcgat

SEQ ID NO: 2457 - RNA, 23 nt, synthetic construct
  source 1..23: mol_type = other RNA
agagaccatagaaggagtcgatg

SEQ ID NO: 2458 - RNA, 23 nt, synthetic construct
  source 1..23: mol_type = other RNA
gagaccatagaaggagtcgatgc

SEQ ID NO: 2459 - RNA, 23 nt, synthetic construct
  source 1..23: mol_type = other RNA
agaccatagaaggagtcgatgct

SEQ ID NO: 2460 - RNA, 23 nt, synthetic construct
  source 1..23: mol_type = other RNA
acccttcaggctccatgaacatc

SEQ ID NO: 2461 - RNA, 23 nt, synthetic construct
  source 1..23: mol_type = other RNA
cttcaggctccatgaacatctac

SEQ ID NO: 2462 - RNA, 23 nt, synthetic construct
  source 1..23: mol_type = other RNA
ttcaggctccatgaacatctacc

SEQ ID NO: 2463 - RNA, 23 nt, synthetic construct
  source 1..23: mol_type = other RNA
catgaacatctacctggtgctag

SEQ ID NO: 2464 - RNA, 23 nt, synthetic construct
  source 1..23: mol_type = other RNA
tgaacatctacctggtgctagat

SEQ ID NO: 2465 - RNA, 23 nt, synthetic construct
  source 1..23: mol_type = other RNA
aacatctacctggtgctagatgg

SEQ ID NO: 2466 - RNA, 23 nt, synthetic construct
  source 1..23: mol_type = other RNA
acatctacctggtgctagatgga

SEQ ID NO: 2467 - RNA, 23 nt, synthetic construct
  source 1..23: mol_type = other RNA
catctacctggtgctagatggat

SEQ ID NO: 2468 - RNA, 23 nt, synthetic construct
  source 1..23: mol_type = other RNA
atctacctggtgctagatggatc

SEQ ID NO: 2469 - RNA, 23 nt, synthetic construct
  source 1..23: mol_type = other RNA
tctacctggtgctagatggatca

SEQ ID NO: 2470 - RNA, 23 nt, synthetic construct
  source 1..23: mol_type = other RNA
ctacctggtgctagatggatcag

SEQ ID NO: 2471 - RNA, 23 nt, synthetic construct
  source 1..23: mol_type = other RNA
tacctggtgctagatggatcaga

SEQ ID NO: 2472 - RNA, 23 nt, synthetic construct
  source 1..23: mol_type = other RNA
cctggtgctagatggatcagaca

SEQ ID NO: 2473 - RNA, 23 nt, synthetic construct
  source 1..23: mol_type = other RNA
tggtgctagatggatcagacagc

SEQ ID NO: 2474 - RNA, 23 nt, synthetic construct
  source 1..23: mol_type = other RNA
ggtgctagatggatcagacagca

SEQ ID NO: 2475 - RNA, 23 nt, synthetic construct
  source 1..23: mol_type = other RNA
tagatggatcagacagcattggg

SEQ ID NO: 2476 - RNA, 23 nt, synthetic construct
  source 1..23: mol_type = other RNA
agcaacttcacaggagccaaaaa

SEQ ID NO: 2477 - RNA, 23 nt, synthetic construct
  source 1..23: mol_type = other RNA
gcaacttcacaggagccaaaaag

SEQ ID NO: 2478 - RNA, 23 nt, synthetic construct
  source 1..23: mol_type = other RNA
caacttcacaggagccaaaaagt

SEQ ID NO: 2479 - RNA, 23 nt, synthetic construct
  source 1..23: mol_type = other RNA
aacttcacaggagccaaaaagtg

SEQ ID NO: 2480 - RNA, 23 nt, synthetic construct
  source 1..23: mol_type = other RNA
acttcacaggagccaaaaagtgt

SEQ ID NO: 2481 - RNA, 23 nt, synthetic construct
  source 1..23: mol_type = other RNA
cttcacaggagccaaaaagtgtc

SEQ ID NO: 2482 - RNA, 23 nt, synthetic construct
  source 1..23: mol_type = other RNA
ttcacaggagccaaaaagtgtct

SEQ ID NO: 2483 - RNA, 23 nt, synthetic construct
  source 1..23: mol_type = other RNA
tcacaggagccaaaaagtgtcta

SEQ ID NO: 2484 - RNA, 23 nt, synthetic construct
  source 1..23: mol_type = other RNA
cacaggagccaaaaagtgtctag

SEQ ID NO: 2485 - RNA, 23 nt, synthetic construct
  source 1..23: mol_type = other RNA
acaggagccaaaaagtgtctagt

SEQ ID NO: 2486 - RNA, 23 nt, synthetic construct
  source 1..23: mol_type = other RNA
caggagccaaaaagtgtctagtc

SEQ ID NO: 2487 - RNA, 23 nt, synthetic construct
  source 1..23: mol_type = other RNA
aggagccaaaaagtgtctagtca

SEQ ID NO: 2488 - RNA, 23 nt, synthetic construct
  source 1..23: mol_type = other RNA
ggagccaaaaagtgtctagtcaa

SEQ ID NO: 2489 - RNA, 23 nt, synthetic construct
  source 1..23: mol_type = other RNA
gagccaaaaagtgtctagtcaac

SEQ ID NO: 2490 - RNA, 23 nt, synthetic construct
  source 1..23: mol_type = other RNA
agccaaaaagtgtctagtcaact

SEQ ID NO: 2491 - RNA, 23 nt, synthetic construct
  source 1..23: mol_type = other RNA
gccaaaaagtgtctagtcaactt

SEQ ID NO: 2492 - RNA, 23 nt, synthetic construct
  source 1..23: mol_type = other RNA
ccaaaaagtgtctagtcaactta

SEQ ID NO: 2493 - RNA, 23 nt, synthetic construct
  source 1..23: mol_type = other RNA
caaaaagtgtctagtcaacttaa

SEQ ID NO: 2494 - RNA, 23 nt, synthetic construct
  source 1..23: mol_type = other RNA
aaaaagtgtctagtcaacttaat

SEQ ID NO: 2495 - RNA, 23 nt, synthetic construct
  source 1..23: mol_type = other RNA
aaaagtgtctagtcaacttaatt

SEQ ID NO: 2496 - RNA, 23 nt, synthetic construct
  source 1..23: mol_type = other RNA
aaagtgtctagtcaacttaattg

SEQ ID NO: 2497 - RNA, 23 nt, synthetic construct
  source 1..23: mol_type = other RNA
aagtgtctagtcaacttaattga

SEQ ID NO: 2498 - RNA, 23 nt, synthetic construct
  source 1..23: mol_type = other RNA
agtgtctagtcaacttaattgag

SEQ ID NO: 2499 - RNA, 23 nt, synthetic construct
  source 1..23: mol_type = other RNA
gtgtctagtcaacttaattgaga

SEQ ID NO: 2500 - RNA, 23 nt, synthetic construct
  source 1..23: mol_type = other RNA
ctagtcaacttaattgagaaggt

SEQ ID NO: 2501 - RNA, 23 nt, synthetic construct
  source 1..23: mol_type = other RNA
cttaattgagaaggtggcaagtt

SEQ ID NO: 2502 - RNA, 23 nt, synthetic construct
  source 1..23: mol_type = other RNA
ttaattgagaaggtggcaagtta

SEQ ID NO: 2503 - RNA, 23 nt, synthetic construct
  source 1..23: mol_type = other RNA
ttgagaaggtggcaagttatggt

SEQ ID NO: 2504 - RNA, 23 nt, synthetic construct
  source 1..23: mol_type = other RNA
tgagaaggtggcaagttatggtg

SEQ ID NO: 2505 - RNA, 23 nt, synthetic construct
  source 1..23: mol_type = other RNA
agaaggtggcaagttatggtgtg

SEQ ID NO: 2506 - RNA, 23 nt, synthetic construct
  source 1..23: mol_type = other RNA
gaaggtggcaagttatggtgtga

SEQ ID NO: 2507 - RNA, 23 nt, synthetic construct
  source 1..23: mol_type = other RNA
tggcaagttatggtgtgaagcca

SEQ ID NO: 2508 - RNA, 23 nt, synthetic construct
  source 1..23: mol_type = other RNA
aagttatggtgtgaagccaagat

SEQ ID NO: 2509 - RNA, 23 nt, synthetic construct
  source 1..23: mol_type = other RNA
ttatggtgtgaagccaagatatg

SEQ ID NO: 2510 - RNA, 23 nt, synthetic construct
  source 1..23: mol_type = other RNA
tatggtgtgaagccaagatatgg

SEQ ID NO: 2511 - RNA, 23 nt, synthetic construct
  source 1..23: mol_type = other RNA
ccaaaatttgggtcaaagtgtct

SEQ ID NO: 2512 - RNA, 23 nt, synthetic construct
  source 1..23: mol_type = other RNA
caaaatttgggtcaaagtgtctg

SEQ ID NO: 2513 - RNA, 23 nt, synthetic construct
  source 1..23: mol_type = other RNA
aaatttgggtcaaagtgtctgaa

SEQ ID NO: 2514 - RNA, 23 nt, synthetic construct
  source 1..23: mol_type = other RNA
cagtaatgcagactgggtcacga

SEQ ID NO: 2515 - RNA, 23 nt, synthetic construct
  source 1..23: mol_type = other RNA
agtaatgcagactgggtcacgaa

SEQ ID NO: 2516 - RNA, 23 nt, synthetic construct
  source 1..23: mol_type = other RNA
gtaatgcagactgggtcacgaag

SEQ ID NO: 2517 - RNA, 23 nt, synthetic construct
  source 1..23: mol_type = other RNA
taatgcagactgggtcacgaagc

SEQ ID NO: 2518 - RNA, 23 nt, synthetic construct
  source 1..23: mol_type = other RNA
tcaatgaaatcaattatgaagac

SEQ ID NO: 2519 - RNA, 23 nt, synthetic construct
  source 1..23: mol_type = other RNA
aatgaaatcaattatgaagacca

SEQ ID NO: 2520 - RNA, 23 nt, synthetic construct
  source 1..23: mol_type = other RNA
gaaatcaattatgaagaccacaa

SEQ ID NO: 2521 - RNA, 23 nt, synthetic construct
  source 1..23: mol_type = other RNA
aaatcaattatgaagaccacaag

SEQ ID NO: 2522 - RNA, 23 nt, synthetic construct
  source 1..23: mol_type = other RNA
aatcaattatgaagaccacaagt

SEQ ID NO: 2523 - RNA, 23 nt, synthetic construct
  source 1..23: mol_type = other RNA
atcaattatgaagaccacaagtt

SEQ ID NO: 2524 - RNA, 23 nt, synthetic construct
  source 1..23: mol_type = other RNA
tcaattatgaagaccacaagttg

SEQ ID NO: 2525 - RNA, 23 nt, synthetic construct
  source 1..23: mol_type = other RNA
caattatgaagaccacaagttga

SEQ ID NO: 2526 - RNA, 23 nt, synthetic construct
  source 1..23: mol_type = other RNA
aattatgaagaccacaagttgaa

SEQ ID NO: 2527 - RNA, 23 nt, synthetic construct
  source 1..23: mol_type = other RNA
attatgaagaccacaagttgaag

SEQ ID NO: 2528 - RNA, 23 nt, synthetic construct
  source 1..23: mol_type = other RNA
ttatgaagaccacaagttgaagt

SEQ ID NO: 2529 - RNA, 23 nt, synthetic construct
  source 1..23: mol_type = other RNA
tatgaagaccacaagttgaagtc

SEQ ID NO: 2530 - RNA, 23 nt, synthetic construct
  source 1..23: mol_type = other RNA
atgaagaccacaagttgaagtca

SEQ ID NO: 2531 - RNA, 23 nt, synthetic construct
  source 1..23: mol_type = other RNA
tgaagaccacaagttgaagtcag

SEQ ID NO: 2532 - RNA, 23 nt, synthetic construct
  source 1..23: mol_type = other RNA
gaagaccacaagttgaagtcagg

SEQ ID NO: 2533 - RNA, 23 nt, synthetic construct
  source 1..23: mol_type = other RNA
agaccacaagttgaagtcaggga

SEQ ID NO: 2534 - RNA, 23 nt, synthetic construct
  source 1..23: mol_type = other RNA
gaccacaagttgaagtcagggac

SEQ ID NO: 2535 - RNA, 23 nt, synthetic construct
  source 1..23: mol_type = other RNA
accacaagttgaagtcagggact

SEQ ID NO: 2536 - RNA, 23 nt, synthetic construct
  source 1..23: mol_type = other RNA
ccacaagttgaagtcagggacta

SEQ ID NO: 2537 - RNA, 23 nt, synthetic construct
  source 1..23: mol_type = other RNA
acaagttgaagtcagggactaac

SEQ ID NO: 2538 - RNA, 23 nt, synthetic construct
  source 1..23: mol_type = other RNA
agttgaagtcagggactaacacc

SEQ ID NO: 2539 - RNA, 23 nt, synthetic construct
  source 1..23: mol_type = other RNA
gttgaagtcagggactaacacca

SEQ ID NO: 2540 - RNA, 23 nt, synthetic construct
  source 1..23: mol_type = other RNA
gaagtcagggactaacaccaaga

SEQ ID NO: 2541 - RNA, 23 nt, synthetic construct
  source 1..23: mol_type = other RNA
aagtcagggactaacaccaagaa

SEQ ID NO: 2542 - RNA, 23 nt, synthetic construct
  source 1..23: mol_type = other RNA
ctccaggcagtgtacagcatgat

SEQ ID NO: 2543 - RNA, 23 nt, synthetic construct
  source 1..23: mol_type = other RNA
tccaggcagtgtacagcatgatg

SEQ ID NO: 2544 - RNA, 23 nt, synthetic construct
  source 1..23: mol_type = other RNA
ccaggcagtgtacagcatgatga

SEQ ID NO: 2545 - RNA, 23 nt, synthetic construct
  source 1..23: mol_type = other RNA
aggcagtgtacagcatgatgagc

SEQ ID NO: 2546 - RNA, 23 nt, synthetic construct
  source 1..23: mol_type = other RNA
gactgatggattgcacaacatgg

SEQ ID NO: 2547 - RNA, 23 nt, synthetic construct
  source 1..23: mol_type = other RNA
actgatggattgcacaacatggg

SEQ ID NO: 2548 - RNA, 23 nt, synthetic construct
  source 1..23: mol_type = other RNA
ctgatggattgcacaacatgggc

SEQ ID NO: 2549 - RNA, 23 nt, synthetic construct
  source 1..23: mol_type = other RNA
tgatggattgcacaacatgggcg

SEQ ID NO: 2550 - RNA, 23 nt, synthetic construct
  source 1..23: mol_type = other RNA
gatggattgcacaacatgggcgg

SEQ ID NO: 2551 - RNA, 23 nt, synthetic construct
  source 1..23: mol_type = other RNA
atggattgcacaacatgggcggg

SEQ ID NO: 2552 - RNA, 23 nt, synthetic construct
  source 1..23: mol_type = other RNA
gggacccaattactgtcattgat

SEQ ID NO: 2553 - RNA, 23 nt, synthetic construct
  source 1..23: mol_type = other RNA
ggacccaattactgtcattgatg

SEQ ID NO: 2554 - RNA, 23 nt, synthetic construct
  source 1..23: mol_type = other RNA
acccaattactgtcattgatgag

SEQ ID NO: 2555 - RNA, 23 nt, synthetic construct
  source 1..23: mol_type = other RNA
actgtcattgatgagatccggga

SEQ ID NO: 2556 - RNA, 23 nt, synthetic construct
  source 1..23: mol_type = other RNA
ctgtcattgatgagatccgggac

SEQ ID NO: 2557 - RNA, 23 nt, synthetic construct
  source 1..23: mol_type = other RNA
gtcattgatgagatccgggactt

SEQ ID NO: 2558 - RNA, 23 nt, synthetic construct
  source 1..23: mol_type = other RNA
tcattgatgagatccgggacttg

SEQ ID NO: 2559 - RNA, 23 nt, synthetic construct
  source 1..23: mol_type = other RNA
cattggcaaggatcgcaaaaacc

SEQ ID NO: 2560 - RNA, 23 nt, synthetic construct
  source 1..23: mol_type = other RNA
attggcaaggatcgcaaaaaccc

SEQ ID NO: 2561 - RNA, 23 nt, synthetic construct
  source 1..23: mol_type = other RNA
ttggcaaggatcgcaaaaaccca

SEQ ID NO: 2562 - RNA, 23 nt, synthetic construct
  source 1..23: mol_type = other RNA
cccaagggaggattatctggatg

SEQ ID NO: 2563 - RNA, 23 nt, synthetic construct
  source 1..23: mol_type = other RNA
gggaggattatctggatgtctat

SEQ ID NO: 2564 - RNA, 23 nt, synthetic construct
  source 1..23: mol_type = other RNA
ggaggattatctggatgtctatg

SEQ ID NO: 2565 - RNA, 23 nt, synthetic construct
  source 1..23: mol_type = other RNA
gaggattatctggatgtctatgt

SEQ ID NO: 2566 - RNA, 23 nt, synthetic construct
  source 1..23: mol_type = other RNA
aggattatctggatgtctatgtg

SEQ ID NO: 2567 - RNA, 23 nt, synthetic construct
  source 1..23: mol_type = other RNA
ggattatctggatgtctatgtgt

SEQ ID NO: 2568 - RNA, 23 nt, synthetic construct
  source 1..23: mol_type = other RNA
gattatctggatgtctatgtgtt

SEQ ID NO: 2569 - RNA, 23 nt, synthetic construct
  source 1..23: mol_type = other RNA
attatctggatgtctatgtgttt

SEQ ID NO: 2570 - RNA, 23 nt, synthetic construct
  source 1..23: mol_type = other RNA
ttatctggatgtctatgtgtttg

SEQ ID NO: 2571 - RNA, 23 nt, synthetic construct
  source 1..23: mol_type = other RNA
tatctggatgtctatgtgtttgg

SEQ ID NO: 2572 - RNA, 23 nt, synthetic construct
  source 1..23: mol_type = other RNA
atctggatgtctatgtgtttggg

SEQ ID NO: 2573 - RNA, 23 nt, synthetic construct
  source 1..23: mol_type = other RNA
tgaaccaagtgaacatcaatgct

SEQ ID NO: 2574 - RNA, 23 nt, synthetic construct
  source 1..23: mol_type = other RNA
gaaccaagtgaacatcaatgctt

SEQ ID NO: 2575 - RNA, 23 nt, synthetic construct
  source 1..23: mol_type = other RNA
aaccaagtgaacatcaatgcttt

SEQ ID NO: 2576 - RNA, 23 nt, synthetic construct
  source 1..23: mol_type = other RNA
accaagtgaacatcaatgctttg

SEQ ID NO: 2577 - RNA, 23 nt, synthetic construct
  source 1..23: mol_type = other RNA
acatcaatgctttggcttccaag

SEQ ID NO: 2578 - RNA, 23 nt, synthetic construct
  source 1..23: mol_type = other RNA
catcaatgctttggcttccaaga

SEQ ID NO: 2579 - RNA, 23 nt, synthetic construct
  source 1..23: mol_type = other RNA
atcaatgctttggcttccaagaa

SEQ ID NO: 2580 - RNA, 23 nt, synthetic construct
  source 1..23: mol_type = other RNA
tttggcttccaagaaagacaatg

SEQ ID NO: 2581 - RNA, 23 nt, synthetic construct
  source 1..23: mol_type = other RNA
gcttccaagaaagacaatgagca

SEQ ID NO: 2582 - RNA, 23 nt, synthetic construct
  source 1..23: mol_type = other RNA
cttccaagaaagacaatgagcaa

SEQ ID NO: 2583 - RNA, 23 nt, synthetic construct
  source 1..23: mol_type = other RNA
tccaagaaagacaatgagcaaca

SEQ ID NO: 2584 - RNA, 23 nt, synthetic construct
  source 1..23: mol_type = other RNA
ccaagaaagacaatgagcaacat

SEQ ID NO: 2585 - RNA, 23 nt, synthetic construct
  source 1..23: mol_type = other RNA
agaaagacaatgagcaacatgtg

SEQ ID NO: 2586 - RNA, 23 nt, synthetic construct
  source 1..23: mol_type = other RNA
aaagacaatgagcaacatgtgtt

SEQ ID NO: 2587 - RNA, 23 nt, synthetic construct
  source 1..23: mol_type = other RNA
aagacaatgagcaacatgtgttc

SEQ ID NO: 2588 - RNA, 23 nt, synthetic construct
  source 1..23: mol_type = other RNA
agacaatgagcaacatgtgttca

SEQ ID NO: 2589 - RNA, 23 nt, synthetic construct
  source 1..23: mol_type = other RNA
gacaatgagcaacatgtgttcaa

SEQ ID NO: 2590 - RNA, 23 nt, synthetic construct
  source 1..23: mol_type = other RNA
caatgagcaacatgtgttcaaag

SEQ ID NO: 2591 - RNA, 23 nt, synthetic construct
  source 1..23: mol_type = other RNA
atgagcaacatgtgttcaaagtc

SEQ ID NO: 2592 - RNA, 23 nt, synthetic construct
  source 1..23: mol_type = other RNA
tgagcaacatgtgttcaaagtca

SEQ ID NO: 2593 - RNA, 23 nt, synthetic construct
  source 1..23: mol_type = other RNA
agcaacatgtgttcaaagtcaag

SEQ ID NO: 2594 - RNA, 23 nt, synthetic construct
  source 1..23: mol_type = other RNA
gcaacatgtgttcaaagtcaagg

SEQ ID NO: 2595 - RNA, 23 nt, synthetic construct
  source 1..23: mol_type = other RNA
caacatgtgttcaaagtcaagga

SEQ ID NO: 2596 - RNA, 23 nt, synthetic construct
  source 1..23: mol_type = other RNA
acatgtgttcaaagtcaaggata

SEQ ID NO: 2597 - RNA, 23 nt, synthetic construct
  source 1..23: mol_type = other RNA
catgtgttcaaagtcaaggatat

SEQ ID NO: 2598 - RNA, 23 nt, synthetic construct
  source 1..23: mol_type = other RNA
atgtgttcaaagtcaaggatatg

SEQ ID NO: 2599 - RNA, 23 nt, synthetic construct
  source 1..23: mol_type = other RNA
tgttcaaagtcaaggatatggaa

SEQ ID NO: 2600 - RNA, 23 nt, synthetic construct
  source 1..23: mol_type = other RNA
gttcaaagtcaaggatatggaaa

SEQ ID NO: 2601 - RNA, 23 nt, synthetic construct
  source 1..23: mol_type = other RNA
ttcaaagtcaaggatatggaaaa

SEQ ID NO: 2602 - RNA, 23 nt, synthetic construct
  source 1..23: mol_type = other RNA
gatgaaagccagtctctgagtct

SEQ ID NO: 2603 - RNA, 23 nt, synthetic construct
  source 1..23: mol_type = other RNA
atgaaagccagtctctgagtctc

SEQ ID NO: 2604 - RNA, 23 nt, synthetic construct
  source 1..23: mol_type = other RNA
tctgagtctctgtggcatggttt

SEQ ID NO: 2605 - RNA, 23 nt, synthetic construct
  source 1..23: mol_type = other RNA
agtctctgtggcatggtttggga

SEQ ID NO: 2606 - RNA, 23 nt, synthetic construct
  source 1..23: mol_type = other RNA
tctgtggcatggtttgggaacac

SEQ ID NO: 2607 - RNA, 23 nt, synthetic construct
  source 1..23: mol_type = other RNA
tgtggcatggtttgggaacacag

SEQ ID NO: 2608 - RNA, 23 nt, synthetic construct
  source 1..23: mol_type = other RNA
ggaagggtaccgattaccacaag

SEQ ID NO: 2609 - RNA, 23 nt, synthetic construct
  source 1..23: mol_type = other RNA
aagggtaccgattaccacaagca

SEQ ID NO: 2610 - RNA, 23 nt, synthetic construct
  source 1..23: mol_type = other RNA
ggtaccgattaccacaagcaacc

SEQ ID NO: 2611 - RNA, 23 nt, synthetic construct
  source 1..23: mol_type = other RNA
taccgattaccacaagcaaccat

SEQ ID NO: 2612 - RNA, 23 nt, synthetic construct
  source 1..23: mol_type = other RNA
accgattaccacaagcaaccatg

SEQ ID NO: 2613 - RNA, 23 nt, synthetic construct
  source 1..23: mol_type = other RNA
cgattaccacaagcaaccatggc

SEQ ID NO: 2614 - RNA, 23 nt, synthetic construct
  source 1..23: mol_type = other RNA
gattaccacaagcaaccatggca

SEQ ID NO: 2615 - RNA, 23 nt, synthetic construct
  source 1..23: mol_type = other RNA
attaccacaagcaaccatggcag

SEQ ID NO: 2616 - RNA, 23 nt, synthetic construct
  source 1..23: mol_type = other RNA
ttaccacaagcaaccatggcagg

SEQ ID NO: 2617 - RNA, 23 nt, synthetic construct
  source 1..23: mol_type = other RNA
acaagcaaccatggcaggccaag

SEQ ID NO: 2618 - RNA, 23 nt, synthetic construct
  source 1..23: mol_type = other RNA
caaccatggcaggccaagatctc

SEQ ID NO: 2619 - RNA, 23 nt, synthetic construct
  source 1..23: mol_type = other RNA
aaccatggcaggccaagatctca

SEQ ID NO: 2620 - RNA, 23 nt, synthetic construct
  source 1..23: mol_type = other RNA
accatggcaggccaagatctcag

SEQ ID NO: 2621 - RNA, 23 nt, synthetic construct
  source 1..23: mol_type = other RNA
gggctgtggtgtctgagtacttt

SEQ ID NO: 2622 - RNA, 23 nt, synthetic construct
  source 1..23: mol_type = other RNA
ggctgtggtgtctgagtactttg

SEQ ID NO: 2623 - RNA, 23 nt, synthetic construct
  source 1..23: mol_type = other RNA
gctgtggtgtctgagtactttgt

SEQ ID NO: 2624 - RNA, 23 nt, synthetic construct
  source 1..23: mol_type = other RNA
ctgtggtgtctgagtactttgtg

SEQ ID NO: 2625 - RNA, 23 nt, synthetic construct
  source 1..23: mol_type = other RNA
tgtggtgtctgagtactttgtgc

SEQ ID NO: 2626 - RNA, 23 nt, synthetic construct
  source 1..23: mol_type = other RNA
tgctgacagcagcacattgtttc

SEQ ID NO: 2627 - RNA, 23 nt, synthetic construct
  source 1..23: mol_type = other RNA
agaagcgggacctggagatagaa

SEQ ID NO: 2628 - RNA, 23 nt, synthetic construct
  source 1..23: mol_type = other RNA
gaagcgggacctggagatagaag

SEQ ID NO: 2629 - RNA, 23 nt, synthetic construct
  source 1..23: mol_type = other RNA
aagaagcaggaattcctgaattt

SEQ ID NO: 2630 - RNA, 23 nt, synthetic construct
  source 1..23: mol_type = other RNA
agaagcaggaattcctgaatttt

SEQ ID NO: 2631 - RNA, 23 nt, synthetic construct
  source 1..23: mol_type = other RNA
aagcaggaattcctgaattttat

SEQ ID NO: 2632 - RNA, 23 nt, synthetic construct
  source 1..23: mol_type = other RNA
agcaggaattcctgaattttatg

SEQ ID NO: 2633 - RNA, 23 nt, synthetic construct
  source 1..23: mol_type = other RNA
gcaggaattcctgaattttatga

SEQ ID NO: 2634 - RNA, 23 nt, synthetic construct
  source 1..23: mol_type = other RNA
caggaattcctgaattttatgac

SEQ ID NO: 2635 - RNA, 23 nt, synthetic construct
  source 1..23: mol_type = other RNA
aggaattcctgaattttatgact

SEQ ID NO: 2636 - RNA, 23 nt, synthetic construct
  source 1..23: mol_type = other RNA
ggaattcctgaattttatgacta

SEQ ID NO: 2637 - RNA, 23 nt, synthetic construct
  source 1..23: mol_type = other RNA
gaattcctgaattttatgactat

SEQ ID NO: 2638 - RNA, 23 nt, synthetic construct
  source 1..23: mol_type = other RNA
aattcctgaattttatgactatg

SEQ ID NO: 2639 - RNA, 23 nt, synthetic construct
  source 1..23: mol_type = other RNA
attcctgaattttatgactatga

SEQ ID NO: 2640 - RNA, 23 nt, synthetic construct
  source 1..23: mol_type = other RNA
ttcctgaattttatgactatgac

SEQ ID NO: 2641 - RNA, 23 nt, synthetic construct
  source 1..23: mol_type = other RNA
tcctgaattttatgactatgacg

SEQ ID NO: 2642 - RNA, 23 nt, synthetic construct
  source 1..23: mol_type = other RNA
ctgaattttatgactatgacgtt

SEQ ID NO: 2643 - RNA, 23 nt, synthetic construct
  source 1..23: mol_type = other RNA
tgaattttatgactatgacgttg

SEQ ID NO: 2644 - RNA, 23 nt, synthetic construct
  source 1..23: mol_type = other RNA
gaattttatgactatgacgttgc

SEQ ID NO: 2645 - RNA, 23 nt, synthetic construct
  source 1..23: mol_type = other RNA
attttatgactatgacgttgccc

SEQ ID NO: 2646 - RNA, 23 nt, synthetic construct
  source 1..23: mol_type = other RNA
ttttatgactatgacgttgccct

SEQ ID NO: 2647 - RNA, 23 nt, synthetic construct
  source 1..23: mol_type = other RNA
tttatgactatgacgttgccctg

SEQ ID NO: 2648 - RNA, 23 nt, synthetic construct
  source 1..23: mol_type = other RNA
ttatgactatgacgttgccctga

SEQ ID NO: 2649 - RNA, 23 nt, synthetic construct
  source 1..23: mol_type = other RNA
tatgactatgacgttgccctgat

SEQ ID NO: 2650 - RNA, 23 nt, synthetic construct
  source 1..23: mol_type = other RNA
atgactatgacgttgccctgatc

SEQ ID NO: 2651 - RNA, 23 nt, synthetic construct
  source 1..23: mol_type = other RNA
ctatgacgttgccctgatcaagc

SEQ ID NO: 2652 - RNA, 23 nt, synthetic construct
  source 1..23: mol_type = other RNA
tatgacgttgccctgatcaagct

SEQ ID NO: 2653 - RNA, 23 nt, synthetic construct
  source 1..23: mol_type = other RNA
atgacgttgccctgatcaagctc

SEQ ID NO: 2654 - RNA, 23 nt, synthetic construct
  source 1..23: mol_type = other RNA
tgacgttgccctgatcaagctca

SEQ ID NO: 2655 - RNA, 23 nt, synthetic construct
  source 1..23: mol_type = other RNA
acgttgccctgatcaagctcaag

SEQ ID NO: 2656 - RNA, 23 nt, synthetic construct
  source 1..23: mol_type = other RNA
cgttgccctgatcaagctcaaga

SEQ ID NO: 2657 - RNA, 23 nt, synthetic construct
  source 1..23: mol_type = other RNA
gccagactatcaggcccatttgt

SEQ ID NO: 2658 - RNA, 23 nt, synthetic construct
  source 1..23: mol_type = other RNA
ccagactatcaggcccatttgtc

SEQ ID NO: 2659 - RNA, 23 nt, synthetic construct
  source 1..23: mol_type = other RNA
cagactatcaggcccatttgtct

SEQ ID NO: 2660 - RNA, 23 nt, synthetic construct
  source 1..23: mol_type = other RNA
agactatcaggcccatttgtctc

SEQ ID NO: 2661 - RNA, 23 nt, synthetic construct
  source 1..23: mol_type = other RNA
gactatcaggcccatttgtctcc

SEQ ID NO: 2662 - RNA, 23 nt, synthetic construct
  source 1..23: mol_type = other RNA
accgagggaacaactcgagcttt

SEQ ID NO: 2663 - RNA, 23 nt, synthetic construct
  source 1..23: mol_type = other RNA
ccgagggaacaactcgagctttg

SEQ ID NO: 2664 - RNA, 23 nt, synthetic construct
  source 1..23: mol_type = other RNA
cgagggaacaactcgagctttga

SEQ ID NO: 2665 - RNA, 23 nt, synthetic construct
  source 1..23: mol_type = other RNA
gggaacaactcgagctttgaggc

SEQ ID NO: 2666 - RNA, 23 nt, synthetic construct
  source 1..23: mol_type = other RNA
ggaacaactcgagctttgaggct

SEQ ID NO: 2667 - RNA, 23 nt, synthetic construct
  source 1..23: mol_type = other RNA
aacaactcgagctttgaggcttc

SEQ ID NO: 2668 - RNA, 23 nt, synthetic construct
  source 1..23: mol_type = other RNA
acaactcgagctttgaggcttcc

SEQ ID NO: 2669 - RNA, 23 nt, synthetic construct
  source 1..23: mol_type = other RNA
caactcgagctttgaggcttcct

SEQ ID NO: 2670 - RNA, 23 nt, synthetic construct
  source 1..23: mol_type = other RNA
tcgagctttgaggcttcctccaa

SEQ ID NO: 2671 - RNA, 23 nt, synthetic construct
  source 1..23: mol_type = other RNA
cgagctttgaggcttcctccaac

SEQ ID NO: 2672 - RNA, 23 nt, synthetic construct
  source 1..23: mol_type = other RNA
gagctttgaggcttcctccaact

SEQ ID NO: 2673 - RNA, 23 nt, synthetic construct
  source 1..23: mol_type = other RNA
agctttgaggcttcctccaacta

SEQ ID NO: 2674 - RNA, 23 nt, synthetic construct
  source 1..23: mol_type = other RNA
gctttgaggcttcctccaactac

SEQ ID NO: 2675 - RNA, 23 nt, synthetic construct
  source 1..23: mol_type = other RNA
ttgaggcttcctccaactaccac

SEQ ID NO: 2676 - RNA, 23 nt, synthetic construct
  source 1..23: mol_type = other RNA
tgaggcttcctccaactaccact

SEQ ID NO: 2677 - RNA, 23 nt, synthetic construct
  source 1..23: mol_type = other RNA
aggcttcctccaactaccacttg

SEQ ID NO: 2678 - RNA, 23 nt, synthetic construct
  source 1..23: mol_type = other RNA
gcttcctccaactaccacttgcc

SEQ ID NO: 2679 - RNA, 23 nt, synthetic construct
  source 1..23: mol_type = other RNA
cttcctccaactaccacttgcca

SEQ ID NO: 2680 - RNA, 23 nt, synthetic construct
  source 1..23: mol_type = other RNA
tccaactaccacttgccagcaac

SEQ ID NO: 2681 - RNA, 23 nt, synthetic construct
  source 1..23: mol_type = other RNA
caactaccacttgccagcaacaa

SEQ ID NO: 2682 - RNA, 23 nt, synthetic construct
  source 1..23: mol_type = other RNA
tgctccctgcacaggatatcaaa

SEQ ID NO: 2683 - RNA, 23 nt, synthetic construct
  source 1..23: mol_type = other RNA
gctccctgcacaggatatcaaag

SEQ ID NO: 2684 - RNA, 23 nt, synthetic construct
  source 1..23: mol_type = other RNA
ctccctgcacaggatatcaaagc

SEQ ID NO: 2685 - RNA, 23 nt, synthetic construct
  source 1..23: mol_type = other RNA
ccctgcacaggatatcaaagctc

SEQ ID NO: 2686 - RNA, 23 nt, synthetic construct
  source 1..23: mol_type = other RNA
cacaggatatcaaagctctgttt

SEQ ID NO: 2687 - RNA, 23 nt, synthetic construct
  source 1..23: mol_type = other RNA
aggatatcaaagctctgtttgtg

SEQ ID NO: 2688 - RNA, 23 nt, synthetic construct
  source 1..23: mol_type = other RNA
tcaaagctctgtttgtgtctgag

SEQ ID NO: 2689 - RNA, 23 nt, synthetic construct
  source 1..23: mol_type = other RNA
aagctgactcggaaggaggtcta

SEQ ID NO: 2690 - RNA, 23 nt, synthetic construct
  source 1..23: mol_type = other RNA
agctgactcggaaggaggtctac

SEQ ID NO: 2691 - RNA, 23 nt, synthetic construct
  source 1..23: mol_type = other RNA
tgactcggaaggaggtctacatc

SEQ ID NO: 2692 - RNA, 23 nt, synthetic construct
  source 1..23: mol_type = other RNA
actcggaaggaggtctacatcaa

SEQ ID NO: 2693 - RNA, 23 nt, synthetic construct
  source 1..23: mol_type = other RNA
ctcggaaggaggtctacatcaag

SEQ ID NO: 2694 - RNA, 23 nt, synthetic construct
  source 1..23: mol_type = other RNA
ggaaggaggtctacatcaagaat

SEQ ID NO: 2695 - RNA, 23 nt, synthetic construct
  source 1..23: mol_type = other RNA
gaaggaggtctacatcaagaatg

SEQ ID NO: 2696 - RNA, 23 nt, synthetic construct
  source 1..23: mol_type = other RNA
ataagaaaggcagctgtgagaga

SEQ ID NO: 2697 - RNA, 23 nt, synthetic construct
  source 1..23: mol_type = other RNA
agaaaggcagctgtgagagagat

SEQ ID NO: 2698 - RNA, 23 nt, synthetic construct
  source 1..23: mol_type = other RNA
gcagctgtgagagagatgctcaa

SEQ ID NO: 2699 - RNA, 23 nt, synthetic construct
  source 1..23: mol_type = other RNA
agctgtgagagagatgctcaata

SEQ ID NO: 2700 - RNA, 23 nt, synthetic construct
  source 1..23: mol_type = other RNA
gctgtgagagagatgctcaatat

SEQ ID NO: 2701 - RNA, 23 nt, synthetic construct
  source 1..23: mol_type = other RNA
ctgtgagagagatgctcaatatg

SEQ ID NO: 2702 - RNA, 23 nt, synthetic construct
  source 1..23: mol_type = other RNA
tgtgagagagatgctcaatatgc

SEQ ID NO: 2703 - RNA, 23 nt, synthetic construct
  source 1..23: mol_type = other RNA
gtgagagagatgctcaatatgcc

SEQ ID NO: 2704 - RNA, 23 nt, synthetic construct
  source 1..23: mol_type = other RNA
cccaggctatgacaaagtcaagg

SEQ ID NO: 2705 - RNA, 23 nt, synthetic construct
  source 1..23: mol_type = other RNA
ccaggctatgacaaagtcaagga

SEQ ID NO: 2706 - RNA, 23 nt, synthetic construct
  source 1..23: mol_type = other RNA
caggctatgacaaagtcaaggac

SEQ ID NO: 2707 - RNA, 23 nt, synthetic construct
  source 1..23: mol_type = other RNA
atgacaaagtcaaggacatctca

SEQ ID NO: 2708 - RNA, 23 nt, synthetic construct
  source 1..23: mol_type = other RNA
cctcggttcctttgtactggagg

SEQ ID NO: 2709 - RNA, 23 nt, synthetic construct
  source 1..23: mol_type = other RNA
ctcggttcctttgtactggagga

SEQ ID NO: 2710 - RNA, 23 nt, synthetic construct
  source 1..23: mol_type = other RNA
tcggttcctttgtactggaggag

SEQ ID NO: 2711 - RNA, 23 nt, synthetic construct
  source 1..23: mol_type = other RNA
ggttcctttgtactggaggagtg

SEQ ID NO: 2712 - RNA, 23 nt, synthetic construct
  source 1..23: mol_type = other RNA
ttcctttgtactggaggagtgag

SEQ ID NO: 2713 - RNA, 23 nt, synthetic construct
  source 1..23: mol_type = other RNA
ctttgtactggaggagtgagtcc

SEQ ID NO: 2714 - RNA, 23 nt, synthetic construct
  source 1..23: mol_type = other RNA
tttgtactggaggagtgagtccc

SEQ ID NO: 2715 - RNA, 23 nt, synthetic construct
  source 1..23: mol_type = other RNA
ttgtactggaggagtgagtccct

SEQ ID NO: 2716 - RNA, 23 nt, synthetic construct
  source 1..23: mol_type = other RNA
gtactggaggagtgagtccctat

SEQ ID NO: 2717 - RNA, 23 nt, synthetic construct
  source 1..23: mol_type = other RNA
actggaggagtgagtccctatgc

SEQ ID NO: 2718 - RNA, 23 nt, synthetic construct
  source 1..23: mol_type = other RNA
tggaggagtgagtccctatgctg

SEQ ID NO: 2719 - RNA, 23 nt, synthetic construct
  source 1..23: mol_type = other RNA
gaggagtgagtccctatgctgac

SEQ ID NO: 2720 - RNA, 23 nt, synthetic construct
  source 1..23: mol_type = other RNA
aggagtgagtccctatgctgacc

SEQ ID NO: 2721 - RNA, 23 nt, synthetic construct
  source 1..23: mol_type = other RNA
cccaatacttgcagaggtgattc

SEQ ID NO: 2722 - RNA, 23 nt, synthetic construct
  source 1..23: mol_type = other RNA
ccaatacttgcagaggtgattct

SEQ ID NO: 2723 - RNA, 23 nt, synthetic construct
  source 1..23: mol_type = other RNA
aatacttgcagaggtgattctgg

SEQ ID NO: 2724 - RNA, 23 nt, synthetic construct
  source 1..23: mol_type = other RNA
tacttgcagaggtgattctggcg

SEQ ID NO: 2725 - RNA, 23 nt, synthetic construct
  source 1..23: mol_type = other RNA
acttgcagaggtgattctggcgg

SEQ ID NO: 2726 - RNA, 23 nt, synthetic construct
  source 1..23: mol_type = other RNA
cttgatagttcacaagagaagtc

SEQ ID NO: 2727 - RNA, 23 nt, synthetic construct
  source 1..23: mol_type = other RNA
ttgatagttcacaagagaagtcg

SEQ ID NO: 2728 - RNA, 23 nt, synthetic construct
  source 1..23: mol_type = other RNA
tgatagttcacaagagaagtcgt

SEQ ID NO: 2729 - RNA, 23 nt, synthetic construct
  source 1..23: mol_type = other RNA
gatagttcacaagagaagtcgtt

SEQ ID NO: 2730 - RNA, 23 nt, synthetic construct
  source 1..23: mol_type = other RNA
atagttcacaagagaagtcgttt

SEQ ID NO: 2731 - RNA, 23 nt, synthetic construct
  source 1..23: mol_type = other RNA
tagttcacaagagaagtcgtttc

SEQ ID NO: 2732 - RNA, 23 nt, synthetic construct
  source 1..23: mol_type = other RNA
agttcacaagagaagtcgtttca

SEQ ID NO: 2733 - RNA, 23 nt, synthetic construct
  source 1..23: mol_type = other RNA
gttcacaagagaagtcgtttcat

SEQ ID NO: 2734 - RNA, 23 nt, synthetic construct
  source 1..23: mol_type = other RNA
ttcacaagagaagtcgtttcatt

SEQ ID NO: 2735 - RNA, 23 nt, synthetic construct
  source 1..23: mol_type = other RNA
tcacaagagaagtcgtttcattc

SEQ ID NO: 2736 - RNA, 23 nt, synthetic construct
  source 1..23: mol_type = other RNA
cacaagagaagtcgtttcattca

SEQ ID NO: 2737 - RNA, 23 nt, synthetic construct
  source 1..23: mol_type = other RNA
acaagagaagtcgtttcattcaa

SEQ ID NO: 2738 - RNA, 23 nt, synthetic construct
  source 1..23: mol_type = other RNA
caagagaagtcgtttcattcaag

SEQ ID NO: 2739 - RNA, 23 nt, synthetic construct
  source 1..23: mol_type = other RNA
aagagaagtcgtttcattcaagt

SEQ ID NO: 2740 - RNA, 23 nt, synthetic construct
  source 1..23: mol_type = other RNA
agagaagtcgtttcattcaagtt

SEQ ID NO: 2741 - RNA, 23 nt, synthetic construct
  source 1..23: mol_type = other RNA
gagaagtcgtttcattcaagttg

SEQ ID NO: 2742 - RNA, 23 nt, synthetic construct
  source 1..23: mol_type = other RNA
agaagtcgtttcattcaagttgg

SEQ ID NO: 2743 - RNA, 23 nt, synthetic construct
  source 1..23: mol_type = other RNA
gaagtcgtttcattcaagttggt

SEQ ID NO: 2744 - RNA, 23 nt, synthetic construct
  source 1..23: mol_type = other RNA
gggagtagtggatgtctgcaaaa

SEQ ID NO: 2745 - RNA, 23 nt, synthetic construct
  source 1..23: mol_type = other RNA
ggagtagtggatgtctgcaaaaa

SEQ ID NO: 2746 - RNA, 23 nt, synthetic construct
  source 1..23: mol_type = other RNA
gagtagtggatgtctgcaaaaac

SEQ ID NO: 2747 - RNA, 23 nt, synthetic construct
  source 1..23: mol_type = other RNA
agtagtggatgtctgcaaaaacc

SEQ ID NO: 2748 - RNA, 23 nt, synthetic construct
  source 1..23: mol_type = other RNA
gtagtggatgtctgcaaaaacca

SEQ ID NO: 2749 - RNA, 23 nt, synthetic construct
  source 1..23: mol_type = other RNA
tagtggatgtctgcaaaaaccag

SEQ ID NO: 2750 - RNA, 23 nt, synthetic construct
  source 1..23: mol_type = other RNA
agtggatgtctgcaaaaaccaga

SEQ ID NO: 2751 - RNA, 23 nt, synthetic construct
  source 1..23: mol_type = other RNA
gtggatgtctgcaaaaaccagaa

SEQ ID NO: 2752 - RNA, 23 nt, synthetic construct
  source 1..23: mol_type = other RNA
tggatgtctgcaaaaaccagaag

SEQ ID NO: 2753 - RNA, 23 nt, synthetic construct
  source 1..23: mol_type = other RNA
atgtctgcaaaaaccagaagcgg

SEQ ID NO: 2754 - RNA, 23 nt, synthetic construct
  source 1..23: mol_type = other RNA
tgtctgcaaaaaccagaagcggc

SEQ ID NO: 2755 - RNA, 23 nt, synthetic construct
  source 1..23: mol_type = other RNA
gtctgcaaaaaccagaagcggca

SEQ ID NO: 2756 - RNA, 23 nt, synthetic construct
  source 1..23: mol_type = other RNA
tgcaaaaaccagaagcggcaaaa

SEQ ID NO: 2757 - RNA, 23 nt, synthetic construct
  source 1..23: mol_type = other RNA
gcaaaaaccagaagcggcaaaag

SEQ ID NO: 2758 - RNA, 23 nt, synthetic construct
  source 1..23: mol_type = other RNA
caaaaaccagaagcggcaaaagc

SEQ ID NO: 2759 - RNA, 23 nt, synthetic construct
  source 1..23: mol_type = other RNA
aaaaaccagaagcggcaaaagca

SEQ ID NO: 2760 - RNA, 23 nt, synthetic construct
  source 1..23: mol_type = other RNA
aaaaccagaagcggcaaaagcag

SEQ ID NO: 2761 - RNA, 23 nt, synthetic construct
  source 1..23: mol_type = other RNA
ccagaagcggcaaaagcaggtac

SEQ ID NO: 2762 - RNA, 23 nt, synthetic construct
  source 1..23: mol_type = other RNA
caaaagcaggtacctgctcacgc

SEQ ID NO: 2763 - RNA, 23 nt, synthetic construct
  source 1..23: mol_type = other RNA
ttcaagtgctgccctggctgaag

SEQ ID NO: 2764 - RNA, 23 nt, synthetic construct
  source 1..23: mol_type = other RNA
cctggctgaaggagaaactccaa

SEQ ID NO: 2765 - RNA, 23 nt, synthetic construct
  source 1..23: mol_type = other RNA
gaaactccaagatgaggatttgg

SEQ ID NO: 2766 - RNA, 23 nt, synthetic construct
  source 1..23: mol_type = other RNA
actccaagatgaggatttgggtt

SEQ ID NO: 2767 - RNA, 23 nt, synthetic construct
  source 1..23: mol_type = other RNA
tccaagatgaggatttgggtttt

SEQ ID NO: 2768 - RNA, 23 nt, synthetic construct
  source 1..23: mol_type = other RNA
caagatgaggatttgggttttct

SEQ ID NO: 2769 - RNA, 23 nt, synthetic construct
  source 1..23: mol_type = other RNA
gcgtgggattgaattaaaacagc

SEQ ID NO: 2770 - RNA, 23 nt, synthetic construct
  source 1..23: mol_type = other RNA
cgtgggattgaattaaaacagct

SEQ ID NO: 2771 - RNA, 23 nt, synthetic construct
  source 1..23: mol_type = other RNA
gtgggattgaattaaaacagctg

SEQ ID NO: 2772 - RNA, 23 nt, synthetic construct
  source 1..23: mol_type = other RNA
ggattgaattaaaacagctgcga

SEQ ID NO: 2773 - RNA, 23 nt, synthetic construct
  source 1..23: mol_type = other RNA
gattgaattaaaacagctgcgac

SEQ ID NO: 2774 - RNA, 23 nt, synthetic construct
  source 1..23: mol_type = other RNA
attgaattaaaacagctgcgaca

SEQ ID NO: 2775 - RNA, 23 nt, synthetic construct
  source 1..23: mol_type = other RNA
ttgaattaaaacagctgcgacaa

SEQ ID NO: 2776 - RNA, 23 nt, synthetic construct
  source 1..23: mol_type = other RNA
tgaattaaaacagctgcgacaac

SEQ ID NO: 2777 - RNA, 23 nt, synthetic construct
  source 1..23: mol_type = other RNA
gaattaaaacagctgcgacaaca
